United States Patent 11,237,155 (SCREENING METHODS USING OLFACTORY RECEPTORS AND NOVEL COMPOUNDS IDENTIFIED USING THE SAME) - sequence listing, part 2

SEQ ID NO: 3789 - DNA, 953 bp, Felis catus
atgacagcacatcaaaatggcaccatctcctttgagatttcagacttcctcctgaattgttttgtcaggtcccccagctggaagctctggttgtccgtgccactcagcctcctctttctcctgggccaatggggagcccaatagtgttctcctgatcaccatctggctggaagcctctctgcatgaacccatgtattacctgctcagtttcctgtcactactggatatcgtgctctgcctcactgtcatccccaaggtcctggccatcttctggtttgacctcaagtccatcagcttctatgcctgcttcctccagatgtacatcatgaattgcttccttggcatggagtcgtgcacattcatggtcatggcctatgaccgctatgtagccatctgccacccactgaggtacccatccatcatcactgaccattttgtagccaaagctgccatttttactttggccagaaatgcacttcttactatattcattcccatcctctctgcacggctccattattgtggaaaaaatataattgataattgtatctgtgccaatctctctgtgtccaagctctcctgtgataatattgcccttaacagaattttccagttaactgtggcctggactctactgggctctgacctgaccctcatcatcttctcctataccttcatcctacgagccgttcttagacttaagacaaaagggtcagctgccaaagctctgaacacttgtggctctcacttcatcctcatcctcttcttcagcaccatcctgctggtttttgttttcacccacattgccaagaaaaaaatttcccctgatatccctgtcttacttaatgtgttacaccatgtaattcctgcagctctcaaccccattgtctatggggtacgaactcaggagattaaagaggggattaggaaattactgaggagggcaagagaga

SEQ ID NO: 3790 - protein, 255 aa, Felis catus
  MOD_RES (255)..(255): Any amino acid
MYYLLSFLSLLDIVLCLTVIPKVLAIFWFDLKSISFYACFLQMYIMNCFLGMESCTFMVMAYDRYVAICHPLRYPSIITDHFVAKAAIFTLARNALLTIFIPILSARLHYCGKNIIDNCICANLSVSKLSCDNIALNRIFQLTVAWTLLGSDLTLIIFSYTFILRAVLRLKTKGSAAKALNTCGSHFILILFFSTILLVFVFTHIAKKKISPDIPVLLNVLHHVIPAALNPIVYGVRTQEIKEGIRKLLRRAREX

SEQ ID NO: 3791 - DNA, 665 bp, Felis catus
agacctcaaggaattgggtcccttgttcttcctggtgtttggcattgtctacctagccaccatttctgggaatcttctcctcgtggtcctggtgagcactcagcggggactccagacaccaatgtacttctttctggtgaacctctcatgcctagaggtctgttatacatccaacattgtgcccatgatgctggtggacttgttaagaaataacagagtgatctccatggcaggttgtgttatgcagctctgcttctctggggctctgggcagcactgaatgttgtcttctggcagcgacgtcatatgactgctacctggccatctgccagcccttgcacgatccaacattaatgcatggaacgatatgtgtagggctagtaattggttcatgggttagtggcttcacagtggcagctgcattccaggctgctatggtacccagtttgaccttctgtgatggcaatgagattaaccatttcttctgtgactgaaacctctgcagaagctctcctgctcagatccccatctggtcaacctggactaacagtgttggttactctggcccctttggactaaccctagtctcttactggaagattctttccatggtcttgcatataacttccatgactggtaggaagaagaccttctccacttgttctt

SEQ ID NO: 3792 - protein, 163 aa, Felis catus
DLKELGPLFFLVFGIVYLATISGNLLLVVLVSTQRGLQTPMYFFLVNLSCLEVCYTSNIVPMMLVDLLRNNRVISMAGCVMQLCFSGALGSTECCLLAATSYDCYLAICQPLHDPTLMHGTICVGLVIGSWVSGFTVAAAFQAAMVPSLTFCDGNEINHFFCD

SEQ ID NO: 3793 - DNA, 719 bp, Felis catus
ttgtggcatgccaacttgggtcttccacattttctcctaaaagacatctatatatggtggtatagcctgatggaattgtatttgttgggcaaactcaactttaccaagcaaggattaacctggaggtctcaagggctttaggctgtaaggcccaagggagggtccctgctctgctggccagttccctggaagagggagaagcagtggcctgaatccccaagtacttcatctagtgcctgactgagcaggatgggcaccatgacaaaggaggccaggaggaaagtggccttctccaccacctcaggatcagaacaggccagatttagtagaggatccaggtcactgaagaagtggccattctcataggctgtacaggatggcagctggaaagtcatgaggacagtgaccacaggggttaggaatccatccagccaaggcccacttgcaaacataatgcacgtgtggaggttcatgagggatgggtactggagagagctgcagatagcaaggtagtggtcagaaggcacggcctggcagcacaaagcactcaactacagctaatgaactgaaggagaactgggccacacaacctgcaaaagaagctgcctcaggatctgagagagggtctgcagcatcttaggggcaacggaagtagtggaccagatgtcaaggaaggaaaaattgaacgaaaagaagtacatgggggtgtggaggctgag

SEQ ID NO: 3794 - protein, 53 aa, Felis catus
LSLHTPMYFFSFNFSFLDIWSTTSVAPKMLQTLSQILRQLLLQVVWPSSPSVH

SEQ ID NO: 3795 - DNA, 905 bp, Felis catus
cttcttaagaacattcctaagtgtttccttcacatctttgttcctcagactatagatcatggggttaagtaagcatggaaatgaccactgtgtaggatacagacaccagcctgtccctgcctagcaagtactcagaggatgggcgcaagtaaatgaatgctgtggttccatagtataggctgacagaagtcaggtgaagaagcacaagtggagaatgttttgtgtttacccttggctgagggaattctgatgataaccaagaaggcatatgcgtaggagaccaggactattgtcagggacacagacacattaaagccaccacaggcaaagaggagaagctggagtatctgtgtgtcagagcaggagagttttaaaaggggaggaatatcacagaaataatgcgtgatgacatgggatttacagaaggtcagataaaaggttgtgctagtaaggagcaccatgttcatcaggcccactgcatagctggcacccacaagctgcaaacagagccttggggacatgatgatatggtagagcagagggctgcagatggccacatggcggtcataggccatggaagccaggaggaagaactcagtgacagcaaagaacacaaaacagcttgtctgtaccacacaaccagagaaggagattgtttggcaaccagagaagaaacccatcaacatttttggaactgtgactgaagaataacagaagtcaataaaggacaaattgctgaggaagaaatacatgggagtgtagagggctgaccacaatgagggcaaggaggcccaggtttcccacaactgtgattgcatagatcaggaggaagagggcaaagaagataggctgaaggtgaggatcgtcagtgaggcccacagtgaagaattcactcaacttgctgg

SEQ ID NO: 3796 - protein, 61 aa, Felis catus
SKLSEFFTVGLTDDPHLQPIFFALFLLIYAITVVGNLGLLALIVVSPLHSHVFLPQQFVLY

SEQ ID NO: 3797 - DNA, 924 bp, Felis catus
ttagggactctgcttcaatattttccataaggcagcttttacttcctggtttctcaagctgtagatgagaggatttaacatggggatcaccattgtataaaacactgaaaccatctgatttcctgcttgggatccacgttgtgagggctgcaagtaagtgtacatagttgttccatagtacaggccaacagcagtcatgtgggaagcacaggtagagaaagctttttgtttgctggaagctgaaggaattcccaggatagtcattaggacagacatgtaggagacaaggatcaccacaatggaggtgaccagggtgaatcccccacagccaacaaccagtatctgcgtgatccaggggtctgagcaagccagtgccaacagtggagggatgtcacagaagaagtggggaaggacacgtggttggcagaatgacagttgtgtgatggaagctgtcacagaaaccatgttaactaaccccccaaagtagcatcctgctaccaagaggagacaacggactctagacattgtgacatggtagagcaatgggtgacagatggcagtgtatcggtcataggccatggaagccaaaagattgcattcagcagaggcaaagataatgaacaagcccatttgagtcacacacccaaggaaagaaacagcctgcaacttagatagcaaatttgctaaagtctttgggatcgtgatggaagagaaacagacatcaagaagggacagattagagagaaaaaagtacatgggagtatgaaggcagggactgactctgatcaggatcaccaggcctagattccccaacatagtgacagtataaacaataagtaagactccaaatagcagcactccaagctgagggttgtctgtcaagccaagaagaatgaagtccgtcaccatggatgaattctccat

SEQ ID NO: 3798 - protein, 307 aa, Felis catus
MENSSMVTDFILLGLTDNPQLGVLLFGVLLIVYTVTMLGNLGLVILIRVSPCLHTPMYFFLSNLSLLDVCFSSITIPKTLANLLSKLQAVSFLGCVTQMGLFIIFASAECNLLASMAYDRYTAICHPLLYHVTMSRVRCLLLVAGCYFGGLVNMVSVTASITQLSFCQPRVLPHFFCDIPPLLALACSDPWITQILVVGCGGFTLVTSIVVILVSYMSVLMTILGIPSASSKQKAFSTCASHMTAVGLYYGTTMYTYLQPSQRGSQAGNQMVSVFYTMVIPMLNPLIYSLRNQEVKAALWKILKQSP

SEQ ID NO: 3799 - DNA, 783 bp, Felis catus
atgcaccaaggaaaccaaagtatctccaaattcttcctcctgggactcactgtggggtctgaacagcagaagctcatctttatgctgtttctgtgcatgtatctggtcaccatggtaggaaacttacttatcatcctggctattatcaatgatgctcaccttcatagccccatgtacttcttccttgccaatctatctttcaatgacatctgcttcacaaccaccacaatccccaaaatgttggcagacatcccaagccaaagcccaaccatctcctttgcaggatgcctcacacaaatgtacttttttatgttgctggtggacctggacaatttccttttggcagccatggcatatgaccggtacgttgccatctgtcacccattacactatgctgcattactgaaccccaagcgttgtgccctgttggtagtgactccatgggtcatctccaatcttgtctcaatactgcatctcagtctgctgagtctcttgactatctgtgatcagagaaaaatcccacactttttctgtgacctggaacccattttaaggtttgcttgctcagacactcaaatcaatgacttgacaatcctagttgttgggggagcagttatctttatccccttcaccttcattattgtctcctatgccattatttgttgcactgtacttggggttacttcagccaaagggaagtggagaacattctccacttgtggctcccatctctcagctgtggccctcttctatggatccattgttggggtatactttctcccc

SEQ ID NO: 3800 - protein, 261 aa, Felis catus
MHQGNQSISKFFLLGLTVGSEQQKLIFMLFLCMYLVTMVGNLLIILAIINDAHLHSPMYFFLANLSFNDICFTTTTIPKMLADIPSQSPTISFAGCLTQMYFFMLLVDLDNFLLAAMAYDRYVAICHPLHYAALLNPKRCALLVVTPWVISNLVSILHLSLLSLLTICDQRKIPHFFCDLEPILRFACSDTQINDLTILVVGGAVIFIPFTFIIVSYAIICCTVLGVTSAKGKWRTFSTCGSHLSAVALFYGSIVGVYFLP

SEQ ID NO: 3801 - DNA, 800 bp, Felis catus
ggaatggacttatcatctttcttatctacattgacccccacctgcacactccaatgtacttcttccttactaatctgtctttcttagacctttgctatggaaccaattccatgccccaggccttggtgcactgtttctctacccatccctacctctcttaccgacgatgtttgacccaaatgagtgtctccttggtcttggccacagcagagtgcctcctattggctgtcatggcctatgatcgtatgattgccatcagcaatcccctgcgctattccatgatcatgaatggcccagtgtgtgtctggctggtggctacctcatggggggcatcacttgtgctcactgctatgctcatcatatccctgccacttcacttctgtggagctaatgtcatcaaccattttgtctgtgagattctttccctccttgagctggcctgttctgataccagcctcaatgagcttatgatcctcaccacaggtatcttcaccctgctcctaccctttggatttgttcttctctcctatatccgaattgccactattgtcctaaggattcgctcagtccggggtaggctcaaggccttttccacctgtggttctcatttgactgtggtgataatcttctatggggcagccatctccatgtatatgaaacctcagtccaagtcatcccctgaccagaacaagtttatttcagtgctttatggggctctgacacccatgctgaaccccctaatatatagcttgaggaacaaggatgttaaaggggcaatgaggaaaattatggcaaaaagg

SEQ ID NO: 3802 - protein, 266 aa, Felis catus
NGLIIFLIYIDPHLHTPMYFFLTNLSFLDLCYGTNSMPQALVHCFSTHPYLSYRRCLTQMSVSLVLATAECLLLAVMAYDRMIAISNPLRYSMIMNGPVCVWLVATSWGASLVLTAMLIISLPLHFCGANVINHFVCEILSLLELACSDTSLNELMILTTGIFTLLLPFGFVLLSYIRIATIVLRIRSVRGRLKAFSTCGSHLTVVIIFYGAAISMYMKPQSKSSPDQNKFISVLYGALTPMLNPLIYSLRNKDVKGAMRKIMAKR

SEQ ID NO: 3803 - DNA, 677 bp, Felis catus
tcaatggtttaaaagacgaccccaccattttttatactagctgttatggtcagatgacaatcactatttttctggggatgacagagtgtctcctccttgctatcatggtttatgatagatttattgcaatatctaatcctctgtgttacaccatcattatgaacaaccaggtctgcatacagttggccatggtgacttgggccactgccttccttttagcaataatactgatcattgcaattcctgcccatttttgtggatgcaatgtcatcaatcaatttacctgtgaggtccaggccctattgaagctcactggctcaaacaccccagtcagacttattctgggtctggtcataggcatattcacactgcccctaccttttatcttcattctcatctcctatactcgcattgtggttgtcatgctaaggatccactctgcagagggcaggctcaaagttttttccacctataggtcccacctgactgtggtcaccatattttatggaacagccatctacatgtacctgaaacctcaattaagggagtcccaggcccagggtaaagtcatctctgcattttatggtgttgtaacttctatgctgaaccccctcatttacaccttgagaaacaaagatgtgaaagatgtcctaagaaaaattatttgaaagaaagaa

SEQ ID NO: 3804 - protein, 221 aa, Felis catus
NGLKDDPTIFYTSCYGQMTITIFLGMTECLLLAIMVYDRFIAISNPLCYTIIMNNQVCIQLAMVTWATAFLLAIILIIAIPAHFCGCNVINQFTCEVQALLKLTGSNTPVRLILGLVIGIFTLPLPFIFILISYTRIVVVMLRIHSAEGRLKVFSTYRSHLTVVTIFYGTAIYMYLKPQLRESQAQGKVISAFYGVVTSMLNPLIYTLRNKDVKDVLRKII

SEQ ID NO: 3805 - DNA, 645 bp, Felis catus
tttttcctcagtaatttatccttccttgatatctgttactccaccagctgggaaccatatgtcttggcccaatgcttcagggacttccccattattttctataccagctgttatgcccagatgaccacatccctctttccagggatgacagaatgtctcttccatgctgtcatggtttatgacaggtttgttgcaatctccaatcccctgcattacaccaccattatgaataatgaagtttgcgtacagttggccttgggaacctgggcaagtgcattcttagtagcagtcttaccattcattgcaattcctgcttgttattatggacagaatgccatcagccattttacctgtgagatccaggccccgctgaagctcatctgctcagacactcctgtcagtctgattctgggtctggttatcagtgtgttcatattgaccttgcctttcactatcatccttatttcctacttccacattgtggttatcgtgctgaggatccattctgtagaggccagcctcaaatctttcttcatctgtggaccttatctaactgtggtcaacatatttaatggtagagccatctacatgtacctgaaacctcaaagaaatctcaggaagaggacaaattcgtctcaatatttt

SEQ ID NO: 3806 - protein, 215 aa, Felis catus
FFLSNLSFLDICYSTSWEPYVLAQCFRDFPIIFYTSCYAQMTTSLFPGMTECLFHAVMVYDRFVAISNPLHYTTIMNNEVCVQLALGTWASAFLVAVLPFIAIPACYYGQNAISHFTCEIQAPLKLICSDTPVSLILGLVISVFILTLPFTIILISYFHIVVIVLRIHSVEASLKSFFICGPYLTVVNIFNGRAIYMYLKPQRNLRKRTNSSQYF

SEQ ID NO: 3807 - DNA, 963 bp, Felis catus
tcaccttgcattgggttcgtgcttcatctggttatagctcttcagaagtctcctgagagcacccttaacttccttgttcctcaggctatagatcatagggtagagcatcggagttacattggtgtagattaaggacacaactttgtcctgttctggggtgtagcatgacttggggcgaatgtagatgaatattgcacagccatagtgcagaacagagaccagcaggtgcccagcacaggtggagaaggctttgctccttccttcagctgagtggattctgaggatggcagcaataatgaatgcataggagagcagaatcagcaagaagggaatcaacaggatgagcatgcagacgaagaagactgcaacctcattggctcttgtgtctgagcaggccagaaatagcacagcagggatgtcacagaaaaaatgattgatctcatgggactgacaaaagggcagtaggaatatcagtgtagtaagggcgagtgagagtgcaaagccgctgatgcatgccagagtcagcatctgcagacagacggtccgggtgatgatgattgtgtagcgcagggggttgcagatggccacaaaacgatcataggccatcatggccaggaggaaacactctgcgccaccgagggcgatgaagaggtgcatttgcaaggcacagcccaggaaggacatccgctggctcctggacaggaaattggccagcatgttagggacaatcaccaatatatagcaaatttcaatggtggacagattgcgaaggaagaaatacatgggggtctggaggcaggagtcaacgagggtgatgagcacaatagttgtgtgccctgctagggtgacaagatgcatgattagaaagagtccaaaaaagaagatttgcagttcacccaggtccccaaaacccaagataataaactcagagcttaaggtgtggtttttctgaaactgggccat

SEQ ID NO: 3808 - protein, 320 aa, Felis catus
MAQFQKNHTLSSEFIILGFGDLGELQIFFFGLFLIMHLVTLAGHTTIVLITLVDSCLQTPMYFFLRNLSTIEICYILVIVPNMLANFLSRSQRMSFLGCALQMHLFIALGGAECFLLAMMAYDRFVAICNPLRYTIIITRTVCLQMLTLACISGFALSLALTTLIFLLPFCQSHEINHFFCDIPAVLFLACSDTRANEVAVFFVCMLILLIPFLLILLSYAFIIAAILRIHSAEGRSKAFSTCAGHLLVSVLHYGCAIFIYIRPKSCYTPEQDKVVSLIYTNVTPMLYPMIYSLRNKEVKGALRRLLKSYNQMKHEPNAR

SEQ ID NO: 3809 - protein, 310 aa, Mus musculus
MATENASVPEFILAGLTDQPGLRMPLFFLFLGFYMVTMVGNLGLITLIGLNSHLHTPMYFFLFNLSLIDFCYSTVITPKMLVSFVSKKNIISYSGCMTQLFFFLFFVVSESFILSAMAYDRYVAICNPLMYTVTMSPQVCLLLLLGVYVMGFAGAMAHTAFMVKLTFCADKLVNHYMCDILPLLERSCTSTYVNELVVFIVVGIDIGVPTVTIFISYALILSSILRISSTEGRSKAFSTCSSHIIAVSLFFGSGAFMYLKPSSLLPMNQGKVSSLFYTIVVPMLNPLIYSLRNKDVKVALRKTLSRSSFS
